United States Patent 10,570,453 (METHOD OF PREDICTING A PREDISPOSITION TO QT PROLONGATION) - sequence listing, part 2

SEQ ID NO: 22 - DNA, 145347 bp, Homo sapiens
  mutation 77898: t/c SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctytctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 23 - DNA, 145347 bp, Homo sapiens
  mutation 77934: t/a SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttawttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 24 - DNA, 145347 bp, Homo sapiens
  mutation 77949: a/c SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgmttctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca
